United States Patent 11,987,791 (COMPOSITIONS AND METHODS FOR MODULATING HEPATOCYTE NUCLEAR FACTOR 4-ALPHA (HNF4α) GENE EXPRESSION) - sequence listing, part 2

SEQ ID NO: 2459 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTHLDLIRHXXXHXXXXXXXCXXCXXXXXSPADLTRHXXXHXXXXXXXCXXCXXXXXHKNALQNHXXXHXXXXXXXCXXCXXXXXQNSTLTEHXXXHXXXXXXXCXXCXXXXXRSDELVRHXXXHXXXXXXXCXXCXXXXXRSDKLVRHXXXHXXXXXXXCXXCXXXXXSKKHLAEHXXXHXXXXXXXXXXX

SEQ ID NO: 2460 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQNSTLTEHXXXHXXXXXXXCXXCXXXXXRSDELVRHXXXHXXXXXXXCXXCXXXXXRSDKLVRHXXXHXXXXXXXCXXCXXXXXSKKHLAEHXXXHXXXXXXXCXXCXXXXXSPADLTRHXXXHXXXXXXXCXXCXXXXXRNDALTEHXXXHXXXXXXXCXXCXXXXXRSDHLTTHXXXHXXXXXXXXXXX

SEQ ID NO: 2461 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSPADLTRHXXXHXXXXXXXCXXCXXXXXHKNALQNHXXXHXXXXXXXCXXCXXXXXQNSTLTEHXXXHXXXXXXXCXXCXXXXXRSDELVRHXXXHXXXXXXXCXXCXXXXXRSDKLVRHXXXHXXXXXXXCXXCXXXXXSKKHLAEHXXXHXXXXXXXCXXCXXXXXSPADLTRHXXXHXXXXXXXXXXX

SEQ ID NO: 2462 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHKNALQNHXXXHXXXXXXXCXXCXXXXXQNSTLTEHXXXHXXXXXXXCXXCXXXXXRSDELVRHXXXHXXXXXXXCXXCXXXXXRSDKLVRHXXXHXXXXXXXCXXCXXXXXSKKHLAEHXXXHXXXXXXXCXXCXXXXXSPADLTRHXXXHXXXXXXXCXXCXXXXXRNDALTEHXXXHXXXXXXXXXXX

SEQ ID NO: 2463 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGHLTEHXXXHXXXXXXXCXXCXXXXXSKKALTEHXXXHXXXXXXXCXXCXXXXXTHLDLIRHXXXHXXXXXXXCXXCXXXXXQNSTLTEHXXXHXXXXXXXCXXCXXXXXDCRDLARHXXXHXXXXXXXCXXCXXXXXRSDKLVRHXXXHXXXXXXXCXXCXXXXXTSGELVRHXXXHXXXXXXXXXXX

SEQ ID NO: 2464 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGNLTEHXXXHXXXXXXXCXXCXXXXXTSGNLTEHXXXHXXXXXXXCXXCXXXXXRSDHLTNHXXXHXXXXXXXCXXCXXXXXDPGHLVRHXXXHXXXXXXXCXXCXXXXXQSGNLTEHXXXHXXXXXXXCXXCXXXXXQSSSLVRHXXXHXXXXXXXCXXCXXXXXHKNALQNHXXXHXXXXXXXXXXX

SEQ ID NO: 2465 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGNLVRHXXXHXXXXXXXCXXCXXXXXTSGNLTEHXXXHXXXXXXXCXXCXXXXXTSGNLTEHXXXHXXXXXXXCXXCXXXXXRSDHLTNHXXXHXXXXXXXCXXCXXXXXDPGHLVRHXXXHXXXXXXXCXXCXXXXXQSGNLTEHXXXHXXXXXXXCXXCXXXXXQSSSLVRHXXXHXXXXXXXXXXX

SEQ ID NO: 2466 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGDLRRHXXXHXXXXXXXCXXCXXXXXRADNLTEHXXXHXXXXXXXCXXCXXXXXHRTTLTNHXXXHXXXXXXXCXXCXXXXXTSHSLTEHXXXHXXXXXXXCXXCXXXXXDKKDLTRHXXXHXXXXXXXCXXCXXXXXDPGALVRHXXXHXXXXXXXCXXCXXXXXHKNALQNHXXXHXXXXXXXXXXX

SEQ ID NO: 2467 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXHRTTLTNHXXXHXXXXXXXCXXCXXXXXTSHSLTEHXXXHXXXXXXXCXXCXXXXXDKKDLTRHXXXHXXXXXXXCXXCXXXXXDPGALVRHXXXHXXXXXXXCXXCXXXXXHKNALQNHXXXHXXXXXXXCXXCXXXXXDCRDLARHXXXHXXXXXXXXXXX

SEQ ID NO: 2468 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHRTTLTNHXXXHXXXXXXXCXXCXXXXXTSHSLTEHXXXHXXXXXXXCXXCXXXXXDKKDLTRHXXXHXXXXXXXCXXCXXXXXDPGALVRHXXXHXXXXXXXCXXCXXXXXHKNALQNHXXXHXXXXXXXCXXCXXXXXDCRDLARHXXXHXXXXXXXCXXCXXXXXQSGNLTEHXXXHXXXXXXXXXXX

SEQ ID NO: 2469 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDTLTEHXXXHXXXXXXXCXXCXXXXXTKNSLTEHXXXHXXXXXXXCXXCXXXXXQNSTLTEHXXXHXXXXXXXCXXCXXXXXERSHLREHXXXHXXXXXXXCXXCXXXXXDPGNLVRHXXXHXXXXXXXCXXCXXXXXTHLDLIRHXXXHXXXXXXXCXXCXXXXXDPGHLVRHXXXHXXXXXXXXXXX

SEQ ID NO: 2470 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQLAHLRAHXXXHXXXXXXXCXXCXXXXXRNDTLTEHXXXHXXXXXXXCXXCXXXXXTKNSLTEHXXXHXXXXXXXCXXCXXXXXQNSTLTEHXXXHXXXXXXXCXXCXXXXXERSHLREHXXXHXXXXXXXCXXCXXXXXDPGNLVRHXXXHXXXXXXXCXXCXXXXXTHLDLIRHXXXHXXXXXXXXXXX

SEQ ID NO: 2471 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXQNSTLTEHXXXHXXXXXXXCXXCXXXXXTTGALTEHXXXHXXXXXXXCXXCXXXXXQAGHLASHXXXHXXXXXXXCXXCXXXXXTSGNLTEHXXXHXXXXXXXCXXCXXXXXTTGNLTVHXXXHXXXXXXXCXXCXXXXXTSHSLTEHXXXHXXXXXXXXXXX

SEQ ID NO: 2472 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGNLTEHXXXHXXXXXXXCXXCXXXXXSKKHLAEHXXXHXXXXXXXCXXCXXXXXRNDALTEHXXXHXXXXXXXCXXCXXXXXRSDHLTNHXXXHXXXXXXXCXXCXXXXXQKSSLIAHXXXHXXXXXXXCXXCXXXXXRSDNLVRHXXXHXXXXXXXCXXCXXXXXQSGDLRRHXXXHXXXXXXXXXXX

SEQ ID NO: 2473 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXTSGNLTEHXXXHXXXXXXXCXXCXXXXXSKKHLAEHXXXHXXXXXXXCXXCXXXXXRNDALTEHXXXHXXXXXXXCXXCXXXXXRSDHLTNHXXXHXXXXXXXCXXCXXXXXQKSSLIAHXXXHXXXXXXXCXXCXXXXXRSDNLVRHXXXHXXXXXXXXXXX

SEQ ID NO: 2474 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSHSLTEHXXXHXXXXXXXCXXCXXXXXDPGHLVRHXXXHXXXXXXXCXXCXXXXXTSGNLTEHXXXHXXXXXXXCXXCXXXXXSKKHLAEHXXXHXXXXXXXCXXCXXXXXRNDALTEHXXXHXXXXXXXCXXCXXXXXRSDHLTNHXXXHXXXXXXXCXXCXXXXXQKSSLIAHXXXHXXXXXXXXXXX

SEQ ID NO: 2475 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGHLTEHXXXHXXXXXXXCXXCXXXXXTSHSLTEHXXXHXXXXXXXCXXCXXXXXDPGHLVRHXXXHXXXXXXXCXXCXXXXXTSGNLTEHXXXHXXXXXXXCXXCXXXXXSKKHLAEHXXXHXXXXXXXCXXCXXXXXRNDALTEHXXXHXXXXXXXCXXCXXXXXRSDHLTNHXXXHXXXXXXXXXXX

SEQ ID NO: 2476 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXTSHSLTEHXXXHXXXXXXXCXXCXXXXXDCRDLARHXXXHXXXXXXXCXXCXXXXXTSGELVRHXXXHXXXXXXXCXXCXXXXXRKDNLKNHXXXHXXXXXXXCXXCXXXXXTSGNLVRHXXXHXXXXXXXCXXCXXXXXQLAHLRAHXXXHXXXXXXXXXXX

SEQ ID NO: 2477 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRANLRAHXXXHXXXXXXXCXXCXXXXXTKNSLTEHXXXHXXXXXXXCXXCXXXXXQRANLRAHXXXHXXXXXXXCXXCXXXXXREDNLHTHXXXHXXXXXXXCXXCXXXXXHKNALQNHXXXHXXXXXXXCXXCXXXXXRTDTLRDHXXXHXXXXXXXCXXCXXXXXSKKHLAEHXXXHXXXXXXXXXXX

SEQ ID NO: 2478 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTKNSLTEHXXXHXXXXXXXCXXCXXXXXQRANLRAHXXXHXXXXXXXCXXCXXXXXREDNLHTHXXXHXXXXXXXCXXCXXXXXHKNALQNHXXXHXXXXXXXCXXCXXXXXRTDTLRDHXXXHXXXXXXXCXXCXXXXXSKKHLAEHXXXHXXXXXXXCXXCXXXXXRSDHLTTHXXXHXXXXXXXXXXX

SEQ ID NO: 2479 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRANLRAHXXXHXXXXXXXCXXCXXXXXREDNLHTHXXXHXXXXXXXCXXCXXXXXHKNALQNHXXXHXXXXXXXCXXCXXXXXRTDTLRDHXXXHXXXXXXXCXXCXXXXXSKKHLAEHXXXHXXXXXXXCXXCXXXXXRSDHLTTHXXXHXXXXXXXCXXCXXXXXTSHSLTEHXXXHXXXXXXXXXXX

SEQ ID NO: 2480 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXREDNLHTHXXXHXXXXXXXCXXCXXXXXHKNALQNHXXXHXXXXXXXCXXCXXXXXRTDTLRDHXXXHXXXXXXXCXXCXXXXXSKKHLAEHXXXHXXXXXXXCXXCXXXXXRSDHLTTHXXXHXXXXXXXCXXCXXXXXTSHSLTEHXXXHXXXXXXXCXXCXXXXXDCRDLARHXXXHXXXXXXXXXXX

SEQ ID NO: 2481 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXRSDHLTTHXXXHXXXXXXXCXXCXXXXXTSHSLTEHXXXHXXXXXXXCXXCXXXXXDCRDLARHXXXHXXXXXXXCXXCXXXXXTSGELVRHXXXHXXXXXXXCXXCXXXXXRKDNLKNHXXXHXXXXXXXCXXCXXXXXTSGNLVRHXXXHXXXXXXXXXXX

SEQ ID NO: 2482 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHKNALQNHXXXHXXXXXXXCXXCXXXXXRTDTLRDHXXXHXXXXXXXCXXCXXXXXSKKHLAEHXXXHXXXXXXXCXXCXXXXXRSDHLTTHXXXHXXXXXXXCXXCXXXXXTSHSLTEHXXXHXXXXXXXCXXCXXXXXDCRDLARHXXXHXXXXXXXCXXCXXXXXTSGELVRHXXXHXXXXXXXXXXX

SEQ ID NO: 2483 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRTDTLRDHXXXHXXXXXXXCXXCXXXXXSKKHLAEHXXXHXXXXXXXCXXCXXXXXRSDHLTTHXXXHXXXXXXXCXXCXXXXXTSHSLTEHXXXHXXXXXXXCXXCXXXXXDCRDLARHXXXHXXXXXXXCXXCXXXXXTSGELVRHXXXHXXXXXXXCXXCXXXXXRKDNLKNHXXXHXXXXXXXXXXX

SEQ ID NO: 2484 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXRSDHLTNHXXXHXXXXXXXCXXCXXXXXSKKHLAEHXXXHXXXXXXXCXXCXXXXXTTGNLTVHXXXHXXXXXXXCXXCXXXXXQNSTLTEHXXXHXXXXXXXCXXCXXXXXDSGNLRVHXXXHXXXXXXXCXXCXXXXXQLAHLRAHXXXHXXXXXXXXXXX

SEQ ID NO: 2485 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXSKKHLAEHXXXHXXXXXXXCXXCXXXXXRSDHLTNHXXXHXXXXXXXCXXCXXXXXSKKHLAEHXXXHXXXXXXXCXXCXXXXXTTGNLTVHXXXHXXXXXXXCXXCXXXXXQNSTLTEHXXXHXXXXXXXCXXCXXXXXDSGNLRVHXXXHXXXXXXXXXXX

SEQ ID NO: 2486 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRRDELNVHXXXHXXXXXXXCXXCXXXXXRADNLTEHXXXHXXXXXXXCXXCXXXXXSKKHLAEHXXXHXXXXXXXCXXCXXXXXRSDHLTNHXXXHXXXXXXXCXXCXXXXXSKKHLAEHXXXHXXXXXXXCXXCXXXXXTTGNLTVHXXXHXXXXXXXCXXCXXXXXQNSTLTEHXXXHXXXXXXXXXXX

SEQ ID NO: 2487 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSHSLTEHXXXHXXXXXXXCXXCXXXXXRRDELNVHXXXHXXXXXXXCXXCXXXXXRADNLTEHXXXHXXXXXXXCXXCXXXXXSKKHLAEHXXXHXXXXXXXCXXCXXXXXRSDHLTNHXXXHXXXXXXXCXXCXXXXXSKKHLAEHXXXHXXXXXXXCXXCXXXXXTTGNLTVHXXXHXXXXXXXXXXX

SEQ ID NO: 2488 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTTGALTEHXXXHXXXXXXXCXXCXXXXXTTGNLTVHXXXHXXXXXXXCXXCXXXXXDCRDLARHXXXHXXXXXXXCXXCXXXXXTSGNLVRHXXXHXXXXXXXCXXCXXXXXTSHSLTEHXXXHXXXXXXXCXXCXXXXXDCRDLARHXXXHXXXXXXXCXXCXXXXXRADNLTEHXXXHXXXXXXXXXXX

SEQ ID NO: 2489 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTKNSLTEHXXXHXXXXXXXCXXCXXXXXTSGNLVRHXXXHXXXXXXXCXXCXXXXXRNDALTEHXXXHXXXXXXXCXXCXXXXXTTGALTEHXXXHXXXXXXXCXXCXXXXXTTGNLTVHXXXHXXXXXXXCXXCXXXXXDCRDLARHXXXHXXXXXXXCXXCXXXXXTSGNLVRHXXXHXXXXXXXXXXX

SEQ ID NO: 2490 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDALTEHXXXHXXXXXXXCXXCXXXXXTTGALTEHXXXHXXXXXXXCXXCXXXXXTTGNLTVHXXXHXXXXXXXCXXCXXXXXDCRDLARHXXXHXXXXXXXCXXCXXXXXTSGNLVRHXXXHXXXXXXXCXXCXXXXXTSHSLTEHXXXHXXXXXXXCXXCXXXXXDCRDLARHXXXHXXXXXXXXXXX

SEQ ID NO: 2491 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGNLVRHXXXHXXXXXXXCXXCXXXXXRNDALTEHXXXHXXXXXXXCXXCXXXXXTTGALTEHXXXHXXXXXXXCXXCXXXXXTTGNLTVHXXXHXXXXXXXCXXCXXXXXDCRDLARHXXXHXXXXXXXCXXCXXXXXTSGNLVRHXXXHXXXXXXXCXXCXXXXXTSHSLTEHXXXHXXXXXXXXXXX

SEQ ID NO: 2492 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXTHLDLIRHXXXHXXXXXXXCXXCXXXXXRSDHLTTHXXXHXXXXXXXCXXCXXXXXQSSNLVRHXXXHXXXXXXXCXXCXXXXXQSGDLRRHXXXHXXXXXXXCXXCXXXXXQRAHLERHXXXHXXXXXXXCXXCXXXXXRNDALTEHXXXHXXXXXXXXXXX

SEQ ID NO: 2493 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTHLDLIRHXXXHXXXXXXXCXXCXXXXXRSDHLTTHXXXHXXXXXXXCXXCXXXXXQSSNLVRHXXXHXXXXXXXCXXCXXXXXQSGDLRRHXXXHXXXXXXXCXXCXXXXXQRAHLERHXXXHXXXXXXXCXXCXXXXXRNDALTEHXXXHXXXXXXXCXXCXXXXXSKKHLAEHXXXHXXXXXXXXXXX

SEQ ID NO: 2494 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHRTTLTNHXXXHXXXXXXXCXXCXXXXXQRAHLERHXXXHXXXXXXXCXXCXXXXXTHLDLIRHXXXHXXXXXXXCXXCXXXXXRSDHLTTHXXXHXXXXXXXCXXCXXXXXQSSNLVRHXXXHXXXXXXXCXXCXXXXXQSGDLRRHXXXHXXXXXXXCXXCXXXXXQRAHLERHXXXHXXXXXXXXXXX

SEQ ID NO: 2495 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXQSSNLVRHXXXHXXXXXXXCXXCXXXXXQSGDLRRHXXXHXXXXXXXCXXCXXXXXQRAHLERHXXXHXXXXXXXCXXCXXXXXRNDALTEHXXXHXXXXXXXCXXCXXXXXSKKHLAEHXXXHXXXXXXXCXXCXXXXXTSGSLVRHXXXHXXXXXXXXXXX

SEQ ID NO: 2496 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSSNLVRHXXXHXXXXXXXCXXCXXXXXQSGDLRRHXXXHXXXXXXXCXXCXXXXXQRAHLERHXXXHXXXXXXXCXXCXXXXXRNDALTEHXXXHXXXXXXXCXXCXXXXXSKKHLAEHXXXHXXXXXXXCXXCXXXXXTSGSLVRHXXXHXXXXXXXCXXCXXXXXRNDTLTEHXXXHXXXXXXXXXXX

SEQ ID NO: 2497 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSSNLVRHXXXHXXXXXXXCXXCXXXXXRNDALTEHXXXHXXXXXXXCXXCXXXXXQRAHLERHXXXHXXXXXXXCXXCXXXXXTTGNLTVHXXXHXXXXXXXCXXCXXXXXRADNLTEHXXXHXXXXXXXCXXCXXXXXRSDNLVRHXXXHXXXXXXXCXXCXXXXXRSDHLTTHXXXHXXXXXXXXXXX

SEQ ID NO: 2498 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDALTEHXXXHXXXXXXXCXXCXXXXXQRAHLERHXXXHXXXXXXXCXXCXXXXXTTGNLTVHXXXHXXXXXXXCXXCXXXXXRADNLTEHXXXHXXXXXXXCXXCXXXXXRSDNLVRHXXXHXXXXXXXCXXCXXXXXRSDHLTTHXXXHXXXXXXXCXXCXXXXXSKKHLAEHXXXHXXXXXXXXXXX

SEQ ID NO: 2499 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXDPGHLVRHXXXHXXXXXXXCXXCXXXXXRSDNLVRHXXXHXXXXXXXCXXCXXXXXRSDHLTTHXXXHXXXXXXXCXXCXXXXXTSGSLVRHXXXHXXXXXXXCXXCXXXXXQSSNLVRHXXXHXXXXXXXCXXCXXXXXRNDALTEHXXXHXXXXXXXXXXX

SEQ ID NO: 2500 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHKNALQNHXXXHXXXXXXXCXXCXXXXXRADNLTEHXXXHXXXXXXXCXXCXXXXXDPGHLVRHXXXHXXXXXXXCXXCXXXXXRSDNLVRHXXXHXXXXXXXCXXCXXXXXRSDHLTTHXXXHXXXXXXXCXXCXXXXXTSGSLVRHXXXHXXXXXXXCXXCXXXXXQSSNLVRHXXXHXXXXXXXXXXX

SEQ ID NO: 2501 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXHKNALQNHXXXHXXXXXXXCXXCXXXXXRADNLTEHXXXHXXXXXXXCXXCXXXXXDPGHLVRHXXXHXXXXXXXCXXCXXXXXRSDNLVRHXXXHXXXXXXXCXXCXXXXXRSDHLTTHXXXHXXXXXXXCXXCXXXXXTSGSLVRHXXXHXXXXXXXXXXX

SEQ ID NO: 2502 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGSLVRHXXXHXXXXXXXCXXCXXXXXQSSNLVRHXXXHXXXXXXXCXXCXXXXXRNDALTEHXXXHXXXXXXXCXXCXXXXXQRAHLERHXXXHXXXXXXXCXXCXXXXXTTGNLTVHXXXHXXXXXXXCXXCXXXXXRADNLTEHXXXHXXXXXXXCXXCXXXXXRSDNLVRHXXXHXXXXXXXXXXX

SEQ ID NO: 2503 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXRSDHLTTHXXXHXXXXXXXCXXCXXXXXTSGSLVRHXXXHXXXXXXXCXXCXXXXXQSSNLVRHXXXHXXXXXXXCXXCXXXXXRNDALTEHXXXHXXXXXXXCXXCXXXXXQRAHLERHXXXHXXXXXXXCXXCXXXXXTTGNLTVHXXXHXXXXXXXXXXX

SEQ ID NO: 2504 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXRSDNLVRHXXXHXXXXXXXCXXCXXXXXRSDHLTTHXXXHXXXXXXXCXXCXXXXXTSGSLVRHXXXHXXXXXXXCXXCXXXXXQSSNLVRHXXXHXXXXXXXCXXCXXXXXRNDALTEHXXXHXXXXXXXCXXCXXXXXQRAHLERHXXXHXXXXXXXXXXX

SEQ ID NO: 2505 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXTSGSLVRHXXXHXXXXXXXCXXCXXXXXQSSNLVRHXXXHXXXXXXXCXXCXXXXXRNDALTEHXXXHXXXXXXXCXXCXXXXXQRAHLERHXXXHXXXXXXXCXXCXXXXXTTGNLTVHXXXHXXXXXXXCXXCXXXXXRADNLTEHXXXHXXXXXXXXXXX

SEQ ID NO: 2506 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXDPGNLVRHXXXHXXXXXXXCXXCXXXXXRRDELNVHXXXHXXXXXXXCXXCXXXXXQLAHLRAHXXXHXXXXXXXCXXCXXXXXERSHLREHXXXHXXXXXXXCXXCXXXXXRSDKLVRHXXXHXXXXXXXCXXCXXXXXTKNSLTEHXXXHXXXXXXXXXXX

SEQ ID NO: 2507 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRKDNLKNHXXXHXXXXXXXCXXCXXXXXRSDHLTTHXXXHXXXXXXXCXXCXXXXXDPGNLVRHXXXHXXXXXXXCXXCXXXXXRRDELNVHXXXHXXXXXXXCXXCXXXXXQLAHLRAHXXXHXXXXXXXCXXCXXXXXERSHLREHXXXHXXXXXXXCXXCXXXXXRSDKLVRHXXXHXXXXXXXXXXX

SEQ ID NO: 2508 - RNA, 2645 nt, Artificial Sequence
  source: /note="Description of Artificial Sequence: Synthetic polynucleotide"
aggaaauaagagagaaaagaagaguaagaagaaauauaagagccaccauggccccgaagaaaaagaggaaggucgggauccacggagucccagccgcaggaagcagcggaagccuggaacccggagaaaaacccuacaagugcccagaaugcggcaagagcuucagccgcagcgaccaccugaccaaccaccagagaacccacaccggagaaaagccauacaaaugcccagagugcgggaaaagcuucagcacaagcggcagccucgucaggcaccagcggacacacaccggcgagaagcccuacaagugcccggaaugcggaaagagcuucagccaagccggacaccucgccagccaccagaggacccacacaggagagaaaccguacaaaugcccggagugcggcaagagcuucagccggagcgacaagcugaccgaacaccagcgaacccacacgggcgaaaagccguacaagugccccgagugcggaaaaagcuucagcacgagcggaaaccucaccgagcaccagcgcacccacacgggagagaagccguacaagugccccgaaugcggaaagagcuucagccagagcagcaaccucgugcgccaccaacggacgcacacaggggaaaagcccuacaagugcccggaaugcggcaaaagcuucagcacccaccuggaccugauccggcaccaacgcacgcacaccggggaaaaaccgaccggaaaaaagaccagcgcgagcggaagcggaggaggaagcggaggcgacgcccuggacgacuucgaccuggacaugcuggggagcgacgcacuggacgacuucgaccuggacaugcugggaagcgacgcgcuggacgacuucgaccuggacaugcugggcagcgacgcccucgacgacuucgaccucgacaugcugagcggcggacccaagaagaagagaaaggucggaagccaguaccucccggacaccgacgacaggcaccgcaucgaagagaagcggaaaagaaccuacgaaaccuucaagagcaucaugaaaaagagcccguucagcggaccaaccgaccccagaccaccaccgagaagaaucgcggucccaagcaggagcagcgccagcgucccgaagccagccccacagccguaccccuucaccagcagccugagcaccaucaacuacgacgaguuccccaccaugguguucccgagcggccagauaagccaggccagcgcacuggcaccagccccaccgcaagugcugccccaagcacccgcaccagcacccgcccccgcgauggucagcgcccuggcacaagccccagccccagucccggugcucgcaccaggaccaccccaagcagucgcaccgccagccccaaagccgacccaagccggagaaggcacccucagcgaggcgcuccugcaacuccaauucgacgacgaggaccugggagcccugcugggcaacagcaccgacccggcaguguucaccgaccuggccagcguggacaacagcgaauuccagcagcuccugaaccaaggaaucccagucgcgccacacaccaccgagccgaugcugauggaauacccagaagcgaucacgagacuggucaccggggcccaaagaccgccggacccagcgccagcaccacugggagccccaggacugcccaacggacugcucagcggcgacgaggacuucagcagcaucgcggacauggacuucagcgcacuccucggaagcggaagcggcagcagagacagccgggaaggaauguuccuccccaagccagaagccggaagcgcaaucagcgacguguucgaaggacgggaagucugccagccgaagcgccucagaccguuccacccaccgggaagcccaugggccaacagaccgcugccagccagccuggcaccgaccccaaccggaccaguccacgaaccagucggcagccugacaccagcaccagugccccagccacuggacccagcaccggcagugaccccagaagccagccaccuccuggaggaccccgacgaagaaaccagccaggccgugaaggcccugagggagauggccgacacggugaucccacagaaggaagaagcagcgaucugcggccaaauggaccucagccacccaccgccaagaggccaccuggacgagcucaccaccacccuggaaagcaugaccgaggaccucaaccucgacagcccccugacaccggagcucaacgagauccuggacaccuuccucaacgacgaaugccugcuccacgccaugcacaucagcaccggacugagcaucuucgacaccagccuguucagcgggggaaaacgaccggcagccaccaaaaaggccggacaggcgaagaagaagaaggggagcuacccguacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2509 - RNA, 627 nt, Artificial Sequence
  source: /note="Description of Artificial Sequence: Synthetic polynucleotide"
cuggaacccggagaaaaacccuacaagugcccagaaugcggcaagagcuucagccgcagcgaccaccugaccaaccaccagagaacccacaccggagaaaagccauacaaaugcccagagugcgggaaaagcuucagcacaagcggcagccucgucaggcaccagcggacacacaccggcgagaagcccuacaagugcccggaaugcggaaagagcuucagccaagccggacaccucgccagccaccagaggacccacacaggagagaaaccguacaaaugcccggagugcggcaagagcuucagccggagcgacaagcugaccgaacaccagcgaacccacacgggcgaaaagccguacaagugccccgagugcggaaaaagcuucagcacgagcggaaaccucaccgagcaccagcgcacccacacgggagagaagccguacaagugccccgaaugcggaaagagcuucagccagagcagcaaccucgugcgccaccaacggacgcacacaggggaaaagcccuacaagugcccggaaugcggcaaaagcuucagcacccaccuggaccugauccggcaccaacgcacgcacaccggggaaaaaccgaccggaaaaaagaccagc

SEQ ID NO: 2510 - protein, 1713 aa, Artificial Sequence; identical to SEQ ID NO: 180
  source: /note="Description of Artificial Sequence: Synthetic polypeptide"

SEQ ID NO: 2511 - DNA, 20 bp, Homo sapiens
aactgaacatcggtgagtta

SEQ ID NO: 2512 - DNA, 20 bp, Homo sapiens
tggtttctggctgacacccg

SEQ ID NO: 2513 - DNA, 20 bp, Homo sapiens
atggttaatcggtcccccgc

SEQ ID NO: 2514 - DNA, 20 bp, Homo sapiens
gtcctctgggaagatctgct

SEQ ID NO: 2515 - DNA, 20 bp, Homo sapiens
ggtttgaaaggaaggcagag

SEQ ID NO: 2516 - DNA, 20 bp, Homo sapiens
accctgggcgcccaccccga

SEQ ID NO: 2517 - DNA, 20 bp, Homo sapiens
tcggggtgggcgcccagggt

SEQ ID NO: 2518 - DNA, 20 bp, Homo sapiens
ttctccctgcctccacgccg

SEQ ID NO: 2519 - DNA, 147 bp, Homo sapiens
actgcgggggaactggaagggagctcccagaacaaggatccagaagattggcatctggggcctgggatttaggtttctaaatcgtgggccatggggcagccttatctctgcaaaagcattgagggtagaagtcaatgatttgggaag

SEQ ID NO: 2520 - DNA, 174 bp, Homo sapiens
tattgaattaggggatctcggaggtaggctgtcagtgcctgatagtatcagttagaatgcctgacttggggtgacaatggcttggaggggtgggtgagtcaagggtcaaatgagtgcccgtgagtcatgatgcctgccttgtacaattgataactgaacatcggtgagttaggg

SEQ ID NO: 2521 - DNA, 20 bp, Homo sapiens
gtgggtgagtcaagggtcaa

SEQ ID NO: 2522 - DNA, 18 bp, Homo sapiens
cccagcagttgtaattag

SEQ ID NO: 2523 - DNA, 167 bp, Homo sapiens
accccgggtgtcagccagaaaccaacaaacagccaaatccctgcagccccgcccagcctatccaccggcgggggaccgattaaccattaacccccacccctccccggcagagcctccaccccttcacagaggctaggccaagactcccagcagatcttcccagagga

SEQ ID NO: 2524 - DNA, 20 bp, Homo sapiens
cagggatttggctgtttgtt

SEQ ID NO: 2525 - DNA, 117 bp, Homo sapiens
ggtttgaaaggaaggcagagagggcactgggaggaggcagtgggagggcggagggcgggggccttcggggtgggcgcccagggtagggcaggtggccgcggcgtggaggcagggaga

SEQ ID NO: 2526 - DNA, 627 bp, Homo sapiens
actgcgggggaactggaagggagctcccagaacaaggatccagaagattggcatctggggcctgggatttaggtttctaaatcgtgggccatggggcagccttatctctgcaaaagcattgagggtagaagtcaatgatttgggaagttattgaattaggggatctcggaggtaggctgtcagtgcctgatagtatcagttagaatgcctgacttggggtgacaatggcttggaggggtgggtgagtcaagggtcaaatgagtgcccgtgagtcatgatgcctgccttgtacaattgataactgaacatcggtgagttagggccccagcagttgtaattagcaccccgggtgtcagccagaaaccaacaaacagccaaatccctgcagccccgcccagcctatccaccggcgggggaccgattaaccattaacccccacccctccccggcagagcctccaccccttcacagaggctaggccaagactcccagcagatcttcccagaggacggtttgaaaggaaggcagagagggcactgggaggaggcagtgggagggcggagggcgggggccttcggggtgggcgcccagggtagggcaggtggccgcggcgtggaggcagggaga

SEQ ID NO: 2527 - DNA, 627 bp, Homo sapiens
tctccctgcctccacgccgcggccacctgccctaccctgggcgcccaccccgaaggcccccgccctccgccctcccactgcctcctcccagtgccctctctgccttcctttcaaaccgtcctctgggaagatctgctgggagtcttggcctagcctctgtgaaggggtggaggctctgccggggaggggtgggggttaatggttaatcggtcccccgccggtggataggctgggcggggctgcagggatttggctgtttgttggtttctggctgacacccggggtgctaattacaactgctggggccctaactcaccgatgttcagttatcaattgtacaaggcaggcatcatgactcacgggcactcatttgacccttgactcacccacccctccaagccattgtcaccccaagtcaggcattctaactgatactatcaggcactgacagcctacctccgagatcccctaattcaataacttcccaaatcattgacttctaccctcaatgcttttgcagagataaggctgccccatggcccacgatttagaaacctaaatcccaggccccagatgccaatcttctggatccttgttctgggagctcccttccagttcccccgcagt
